United States Patent 11,965,185 (LACHNOSPIRACEAE SP. CAS12A MUTANTS WITH ENHANCED CLEAVAGE ACTIVITY AT NON-CANONICAL TTTT PROTOSPACER ADJACENT MOTIFS) - sequence listing, part 3

SEQ ID NO: 1940 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSIRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1941 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtacctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1942 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGTFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1943 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagacctggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1944 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQTWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1945 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgtctaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1946 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVSNSDGIFYDSRNYEAQENAILPKNADANGAYNIARKVLWAIGQFKKAEDEKLDKVKIAISNKEWLEYAQTSVKH

SEQ ID NO: 1947 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaagaaggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1948 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTEEGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1949 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtggcctgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1950 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGGLKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1951 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgggcacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1952 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLGTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1953 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatccgtgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1954 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIRDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1955 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttattatagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1956 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYYSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1957 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccccgaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1958 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTPKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1959 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtcgtctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1960 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICRLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1961 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatatttataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1962 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDIYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1963 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagctttagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1964 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESFSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1965 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaacagtatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1966 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKQYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1967 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcaaatatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1968 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSKYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1969 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcacccgtaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1970 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTRKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1971 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttgtggaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1972 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFVEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1973 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaacctgctatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1974 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTCYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1975 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtcagcgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1976 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGQRNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1977 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaataacaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1978 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNNNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1979 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaagcgacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1980 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKATRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1981 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaacagaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1982 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKQKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1983 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaaaccgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1984 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFETALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1985 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgtctttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1986 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPSFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1987 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgatttttggtttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1988 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFWFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1989 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttctggcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1990 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVLALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1991 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcaggcgatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1992 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQAIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1993 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaatgagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1994 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAMSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1995 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgatgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1996 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIDDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1997 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagataacagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 1998 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDNSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1999 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacaggaaagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2000 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQESLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2001 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattatgctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2002 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIMLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2003 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaaaacctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2004 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPENLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2005 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaactgatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2006 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKELIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2007 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggccatgaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2008 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGHETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2009 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagagcgtgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2010 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKERDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2011 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcgtgaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2012 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSVKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2013 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttcgtagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2014 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFRSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2015 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgttttttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2016 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVFFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2017 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgctgaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2018 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPLNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2019 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttgtgggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2020 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFVGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2021 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgtgagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2022 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFVSASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2023 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcatttggggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2024 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSIWGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2025 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaattgctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2026 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNCFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2027 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattaccgtaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2028 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYRNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2029 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttcgtaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2030 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFRNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2031 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgctgacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2032 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLLTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2033 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtcgtcgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2034 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGRRNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2035 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcggctatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2036 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGGYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2037 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaattacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2038 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKITTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2039 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaacgtacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2040 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKRTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2041 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatggtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2042 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNMVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2043 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacagaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2044 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGEQNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2045 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtatgtttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2046 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGMFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2047 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtctgggatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2048 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVWDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2049 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttccgctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2050 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFPLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2051 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatcaggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2052 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDQAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2053 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttccgaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2054 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFPNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2055 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgaggaaaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2056 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEEKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2057 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctgaaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2058 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLKQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2059 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgatgaaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2060 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPMKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2061 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggatatggataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2062 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDMDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2063 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattaaagcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2064 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIKAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2065 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagcgatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2066 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSDDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2067 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagtgcgatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2068 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSAMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2069 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatatatggaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2070 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYMELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2071 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaataaaggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2072 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNKGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2073 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaatgctacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2074 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETECYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2075 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccgcggttaaacat

SEQ ID NO: 2076 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTAVKH

SEQ ID NO: 2077 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgcatgtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2078 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVHVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2079 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatctttaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2080 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIFKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2081 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgtgggattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2082 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLWDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2083 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaaaaacgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2084 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEKRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2085 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgccatgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2086 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRHDVDFLISPVKNSDGIFYDSRNYEAQENAILPKNADANGAYNIARKVLWAIGQFKKAEDEKLDKVKIAISNKEWLEYAQTSVKH

SEQ ID NO: 2087 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtgtataaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2088 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVYKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2089 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaacgtctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2090 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKRLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2091 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaccttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2092 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDTFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2093 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttcagctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2094 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFQLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2095 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatgtgcctgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2096 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMCLMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2097 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgccgaaagtgaaaattgcgatcagcaataaagagtggctggaatacgcacagaccagcgttaaacat

SEQ ID NO: 2098 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLPKVKIAISNKEWLEYAQTSVKH

SEQ ID NO: 2099 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagcagctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2100 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQQLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2101 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagcttttttagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2102 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFFSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2103 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctggtgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2104 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLVYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2105 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttgaaccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2106 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVEPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2107 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgtttttatgcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2108 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFYARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2109 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcgcgaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2110 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIAKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2111 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaaaatatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2112 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKKYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2113 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaattttattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2114 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNFITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2115 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccggcgttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2116 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPAFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2117 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgcgtaaagtgaaaattgcgatcagcaataaagagtggctggaatacgcacagaccagcgttaaacat

SEQ ID NO: 2118 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLRKVKIAISNKEWLEYAQTSVKH

SEQ ID NO: 2119 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcctgaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2120 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIILTILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2121 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagctctcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2122 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSSRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2123 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaacctggcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2124 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETWRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2125 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgatgaaagtgaaaattgcgatcagcaataaagagtggctggaatacgcacagaccagcgttaaacat

SEQ ID NO: 2126 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLMKVKIAISNKEWLEYAQTSVKH

SEQ ID NO: 2127 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcaccattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2128 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHITIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2129 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagcggcgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2130 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSGDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2131 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaataacccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2132 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANNPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2133 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattctatctggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2134 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFYLDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2135 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaatttgcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2136 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEICNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2137 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaacagctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2138 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKQLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2139 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctgctgaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2140 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELLNLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2141 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgacctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2142 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVTFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2143 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgaggcgtttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2144 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEAFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2145 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatctctatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2146 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGISIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2147 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccgtctgaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2148 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPSEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2149 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgaaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2150 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRESLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2151 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgcgtgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2152 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPRANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2153 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttcgtcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2154 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFRRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2155 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgctgaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2156 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPLNADANGAYNIARKVLWAIGQFKKAEDEKLDKVKIAISNKEWLEYAQTSVKH

SEQ ID NO: 2157 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcgcggataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2158 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIADKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2159 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagggctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2160 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEGYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2161 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttgatgcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2162 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFDALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2163 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgactgcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2164 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDCEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2165 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaatatatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2166 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQYIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2167 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaatttgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2168 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKFEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2169 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaactgctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2170 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNCFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2171 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaatatctgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2172 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEYLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2173 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacaggaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2174 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQELPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2175 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaggcagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2176 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKGSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2177 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacatgctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2178 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNMLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2179 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaagcggccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2180 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEAALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2181 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgtgcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2182 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLCDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2183 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacagcgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2184 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTASYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2185 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctgaactatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2186 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLNYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2187 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaacattttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2188 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKHFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2189 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaattaaacgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2190 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSIKRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2191 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacaccgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2192 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNTDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2193 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcaccatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2194 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSTIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2195 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgtatttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2196 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPYFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2197 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgataaatatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2198 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDKYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2199 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaggcgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2200 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEGALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2201 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcacccattttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2202 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTHFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2203 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgggcagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2204 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLGSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2205 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtgcagcagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2206 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVQQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2207 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaacagcttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2208 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKQLFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2209 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatccgtaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2210 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIRKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2211 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatccataactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2212 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIIHNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2213 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtattctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2214 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICILVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2215 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgaaaaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2216 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAKKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2217 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaatggaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2218 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEMENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2219 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgcagacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2220 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLQTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2221 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctggaaaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2222 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLEKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2223 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattgcgggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2224 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSIAGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2225 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagatttttgggacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2226 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFWDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2227 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaacgtatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2228 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKRIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2229 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacaggtgctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2230 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQVLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2231 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgagcagattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2232 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEQIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2233 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgtttgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2234 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPFEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2235 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttggcggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2236 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFGGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2237 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggccatttataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2238 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAIYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2239 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgcaggacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2240 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLQDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2241 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacccgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2242 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDPFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2243 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacctgtatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2244 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNLYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2245 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggtccggtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2246 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGPVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2247 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaactggaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2248 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKLEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2249 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtaaatttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2250 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGKFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2251 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtgtgctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2252 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERVLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2253 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtattgccaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2254 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYCQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2255 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaactgctttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2256 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINCFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2257 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgaatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2258 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIEFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2259 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttataaagaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2260 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYKEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2261 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgaaccgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2262 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLNRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2263 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatggcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2264 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYGNLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2265 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaaaaaggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2266 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKKGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2267 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgcggaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2268 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDAEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2269 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaaattgaagatgagaagctggacaaagtgaaaattgcgatcagcaataaagagtggctggaatacgcacagaccagcgttaaacat

SEQ ID NO: 2270 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKIEDEKLDKVKIAISNKEWLEYAQTSVKH

SEQ ID NO: 2271 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgcgtgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2272 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLRDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2273 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtgcaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2274 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKACKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2275 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgaactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2276 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIELEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2277 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgccgaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2278 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLPNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2279 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaggctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2280 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKGCELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2281 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagtctaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2282 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGESKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2283 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggctttttttataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2284 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFYNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2285 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagtggctgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2286 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQWLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2287 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaaccagatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2288 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNQMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2289 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgaccattataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2290 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDHYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2291 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgtattgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2292 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALYCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2293 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaacatcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2294 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEHRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2295 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgtttttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2296 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPFFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2297 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctgtggagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2298 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLWSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2299 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatattatattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2300 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYYIARKVLWAIGQFKKAEDEKLDKVKIAISNKEWLEYAQTSVKH

SEQ ID NO: 2301 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagcataccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2302 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQHTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2303 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaaccatgattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2304 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNHDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2305 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaaccatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2306 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSATIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2307 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtaaaagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2308 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRKSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2309 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaaggcatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2310 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKGIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2311 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaagtgaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2312 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKVNYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2313 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatcatgcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2314 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDHAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2315 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactattctagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2316 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYSSLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2317 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctcctctgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2318 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSSADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2319 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttgcaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2320 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQICNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2321 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagcccgttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2322 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKARFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2323 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgaagttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2324 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDEVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2325 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagataaaaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2326 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDKNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2327 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgaccatgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2328 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDHEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2329 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcattgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2330 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFIEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2331 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatctgagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2332 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYLSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2333 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaaaacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2334 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKNGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2335 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattttttatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2336 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIFYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2337 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatgaacaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2338 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDEQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2339 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggttggtataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2340 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGWYNIARKVLWAIGQFKKAEDEKLDKVKIAISNKEWLEYAQTSVKH

SEQ ID NO: 2341 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctgtggatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2342 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLWINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2343 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggtgctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2344 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEVLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2345 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgactggaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2346 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADWKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2347 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatcatcacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2348 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDHHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2349 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgatccgcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2350 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDPRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2351 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgcataaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2352 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLHKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2353 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgatgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2354 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDDDYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2355 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtattgcgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2356 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYCVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2357 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatcaaagataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2358 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIKDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2359 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacattttatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2360 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTFYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2361 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagcgtatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2362 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQRMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2363 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccccgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2364 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTPTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2365 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattattggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2366 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIIGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2367 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagatgtggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2368 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQMWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2369 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgatctggcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2370 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDLAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2371 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgtctacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2372 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLSTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2373 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagcatcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2374 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQHRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2375 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgggcatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2376 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLGMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2377 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaacatattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2378 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKHIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2379 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtggatgagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2380 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVDEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2381 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgaggtgaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2382 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEVKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2383 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaatggaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2384 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKWTNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2385 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgtttgcgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2386 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVCESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2387 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacctgaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2388 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYLKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2389 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgaacgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2390 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLNDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2391 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagtatattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2392 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKYIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2393 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcgcggaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2394 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIAELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2395 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaaatggcacagaccagcgttaaacat

SEQ ID NO: 2396 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEMAQTSVKH

SEQ ID NO: 2397 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggtccgattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2398 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGPISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2399 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtattatattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2400 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYYIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2401 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggtggcattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2402 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGGISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2403 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatacatgctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2404 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYMLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2405 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgtgcacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2406 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLCTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2407 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattgatctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2408 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDIDLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2409 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaatttttaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2410 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIFNNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2411 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaagatgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2412 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKDDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2413 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaattgccgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2414 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINCRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2415 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaaccatgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2416 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNHVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2417 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtgatgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2418 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGDDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2419 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagatgattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2420 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKMISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2421 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccatggcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2422 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAMAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2423 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctgggatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2424 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSWDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2425 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctgatgatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2426 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLMINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2427 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatacccgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2428 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDTRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2429 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataaggatgttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2430 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKDVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2431 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcggcgatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2432 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISGDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2433 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggtttatagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2434 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVYSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2435 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaatgggatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2436 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKWDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2437 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgccatcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2438 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCHQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2439 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtaaactggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2440 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICKLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2441 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccgtgatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2442 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAVMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2443 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaagaaaaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2444 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDEENHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2445 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggccagccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2446 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGQPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2447 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcctggatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2448 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGLDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2449 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaagaaacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2450 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKETSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2451 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaacgttacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2452 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKRYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2453 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatccgtcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2454 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIRQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2455 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagcagtttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2456 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEQFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2457 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgcgtctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2458 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLRLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2459 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattctgcgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2460 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNILRKVLWAIGQFKKAEDEKLDKVKIAISNKEWLEYAQTSVKH

SEQ ID NO: 2461 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaagtgaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2462 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKVTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2463 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatccgtattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2464 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIRIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2465 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaactgccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2466 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKLPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2467 - DNA, 3684 bp, Artificial Sequence
  Synthetic
atgagcaaactggaaaagttcaccaactgttatagcctgagcaaagcgctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2468 - protein, 1228 aa, Artificial Sequence
  Synthetic
MSKLEKFTNCYSLSKALRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2469 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatcaggtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2470 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYQVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2471 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaaatgatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2472 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKMIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2473 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatctttgcggatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2474 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFADSRNYEAQENAILPKNADANGAYNIARKVLWAIGQFKKAEDEKLDKVKIAISNKEWLEYAQTSVKH

SEQ ID NO: 2475 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatggctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2476 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNGFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2477 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatataccctgattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2478 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTLIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2479 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagccgctggacaaagtgaaaattgcgatcagcaataaagagtggctggaatacgcacagaccagcgttaaacat

SEQ ID NO: 2480 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEPLDKVKIAISNKEWLEYAQTSVKH

SEQ ID NO: 2481 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaagatctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2482 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKDLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2483 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgaccggctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2484 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTGYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2485 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatatttgggcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2486 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIWALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2487 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaattaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2488 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKEINRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2489 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgcatgcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2490 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVHAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2491 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaccgctgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2492 - protein, 1228 aa, Artificial Sequence
  Synthetic
MSKLEKFTNCYSLSKTLRFKAIPVGKTQENIDNKRLLVEDEKRAEDYKGVKPLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2493 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaaatgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2494 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAEMFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2495 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcaacaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2496 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKINNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2497 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgctctcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2498 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRSRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2499 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatcagcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2500 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHQQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2501 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagtgcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2502 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQECKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2503 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggtccgaaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2504 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGPKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2505 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacaggatagcgttaaacat

SEQ ID NO: 2506 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQDSVKH

SEQ ID NO: 2507 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaagattatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2508 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKDYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2509 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattgaacagtttaagaaagcagaagatgagaagctggacaaagtgaaaattgcgatcagcaataaagagtggctggaatacgcacagaccagcgttaaacat

SEQ ID NO: 2510 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIEQFKKAEDEKLDKVKIAISNKEWLEYAQTSVKH

SEQ ID NO: 2511 - DNA, 3684 bp, Artificial Sequence
  Synthetic
atgagcatgctggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2512 - protein, 1228 aa, Artificial Sequence
  Synthetic
MSMLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2513 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccggtgttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2514 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPVFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2515 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctggcggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2516 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLADKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2517 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcatgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2518 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNHDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2519 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggcgaaaaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2520 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGEKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2521 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtatgggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2522 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGMGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2523 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactggatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2524 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNWISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2525 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacggcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2526 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADGKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2527 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggcgaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2528 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELANLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2529 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaattttttagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2530 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFFSFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2531 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaataacattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2532 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENNILPKNADANGAYNIARKVLWAIGQFKKAEDEKLDKVKIAISNKEWLEYAQTSVKH

SEQ ID NO: 2533 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgaaattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2534 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYEILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2535 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgccgttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2536 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPPFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2537 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatcgtgatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2538 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYRDADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2539 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcaggcattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2540 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAGIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2541 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaaaaagcacagaccagcgttaaacat

SEQ ID NO: 2542 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEKAQTSVKH

SEQ ID NO: 2543 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaatttaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2544 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKFKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2545 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgtctgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2546 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLSDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2547 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcaaaattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2548 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIKIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2549 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaattttggctggaatacgcacagaccagcgttaaacat

SEQ ID NO: 2550 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKFWLEYAQTSVKH

SEQ ID NO: 2551 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagggctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2552 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEGFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2553 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatatgtttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2554 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNMFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2555 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttggcaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2556 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFGNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2557 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgaagacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2558 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIEDSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2559 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaacctttcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2560 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETFRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2561 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcccgaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2562 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSPKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2563 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgatgtgtggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2564 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDVWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2565 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaagaaacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2566 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKETTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2567 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggatgctgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2568 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWMLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2569 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttaaagagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2570 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFKEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2571 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagccgtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2572 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKPFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2573 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctggatgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2574 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLDVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2575 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcgcgtatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2576 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGAYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2577 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttctccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2578 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRSPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2579 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgctggacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2580 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLLDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2581 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttattgcagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2582 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYCSRNYEAQENAILPKNADANGAYNIARKVLWAIGQFKKAEDEKLDKVKIAISNKEWLEYAQTSVKH

SEQ ID NO: 2583 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagcagtataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2584 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEQYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2585 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacctgtttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2586 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINLFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2587 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttatttttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2588 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFIFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2589 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccggaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2590 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPENADANGAYNIARKVLWAIGQFKKAEDEKLDKVKIAISNKEWLEYAQTSVKH

SEQ ID NO: 2591 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagaggatgaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2592 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKEDENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2593 - DNA, 3684 bp, Artificial Sequence
  Synthetic
atgcataaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2594 - protein, 1228 aa, Artificial Sequence
  Synthetic
MHKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2595 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcgaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2596 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGEETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2597 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaagaattcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2598 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKEFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2599 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacagtgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2600 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTVSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2601 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatccagcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2602 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIQQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2603 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacggcaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2604 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYGKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2605 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatattggtccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2606 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYWSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2607 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatattagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2608 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNISRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2609 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttctttaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2610 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFFNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2611 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcatattatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2612 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHIICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2613 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgccgaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2614 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLPKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2615 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggatgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2616 - protein, 1228 aa, Artificial Sequence
  Synthetic
MSKLEKFTNCYSLSKTLRFKAIPVGKTQENIDNKRLLDEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2617 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgatatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2618 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIDINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2619 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaattgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2620 - protein, 1228 aa, Artificial Sequence
  Synthetic
MSKLEKFTNCYSLSKTLRFKAIPVGKTQENIDNKRLLVEDEKRAEDYKIVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2621 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgatgaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2622 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVDEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2623 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagatgaagttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2624 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADEVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2625 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgcgtgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2626 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPRVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2627 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctgtataaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2628 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLYKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2629 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgcatgtatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2630 - protein, 1228 aa, Artificial Sequence
  Synthetic
MSKLEKFTNCYSLSKTLRFKAIPVGKTQENIDNKRLLVEDEKRAEDYKGVKKLLDRMYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2631 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactggtgatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2632 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLVMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2633 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgaggaatacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2634 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFEEYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2635 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaaccgtgatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2636 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNRDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2637 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccccgggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2638 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATPGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2639 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggtctgcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2640 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWSAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2641 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaagaaagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2642 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKESEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2643 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaggcaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2644 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKEGKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2645 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattccagccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2646 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFQPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2647 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctggatcgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2648 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLDRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2649 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttgtgaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2650 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFVNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2651 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatcgtaagctggacaaagtgaaaattgcgatcagcaataaagagtggctggaatacgcacagaccagcgttaaacat

SEQ ID NO: 2652 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDRKLDKVKIAISNKEWLEYAQTSVKH

SEQ ID NO: 2653 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaatgcaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2654 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKCNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2655 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagctggaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2656 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSWKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2657 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaaaaattttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2658 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKKFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2659 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaaaacctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2660 - protein, 1228 aa, Artificial Sequence
  Synthetic
MSKLEKFTNCYSLSKTLRFKAIPVGKTQENIDNKNLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2661 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgattttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2662 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLIFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2663 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgtggttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2664 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAWFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2665 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaatattcatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2666 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENIHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2667 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattctctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2668 - protein, 1228 aa, Artificial Sequence
  Synthetic
MSKLEKFTNCYSLSKTLRFKAIPVGKTQENIDNKRLLVEDEKRAEDYKGVKKLLDRYSLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2669 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatgtgagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2670 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYVSLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2671 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaagtgctgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2672 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEVLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2673 - DNA, 3684 bp, Artificial Sequence
  Synthetic
atgagcaaactggaaaagttcaccaactgttatagcctgagcaaaaccctgcgttttaaagcaattccggttggtgtgacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2674 - protein, 1228 aa, Artificial Sequence
  Synthetic
MSKLEKFTNCYSLSKTLRFKAIPVGVTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2675 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaccaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2676 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDTKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2677 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtctgctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2678 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICLLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2679 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattcgtggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2680 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIRGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2681 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgtctgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2682 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLSEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2683 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaataccccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2684 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANTPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2685 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacagcgtatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2686 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTAYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2687 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagggcatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2688 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQGMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2689 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgaactggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2690 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFELAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2691 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgattggaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2692 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDWKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2693 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgctgattgcgatcagcaataaagagtggctggaatacgcacagaccagcgttaaacat

SEQ ID NO: 2694 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVLIAISNKEWLEYAQTSVKH

SEQ ID NO: 2695 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaacgtattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2696 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKRIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2697 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgctatcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2698 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRYRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2699 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccgtggatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2700 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTVDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2701 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgctgtacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2702 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLLYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2703 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaacagtgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2704 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKQCELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2705 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatgaatttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2706 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDEFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2707 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgtgaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2708 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFVNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2709 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaagaaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2710 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKEKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2711 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgtcgtccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2712 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRRPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2713 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaagcgctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2714 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINEALTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2715 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgatggatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2716 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLMDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2717 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacgcggaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2718 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINAEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2719 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatcgttataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2720 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDRYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2721 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtaccagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2722 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRTSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2723 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcaccgatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2724 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSTDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2725 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaacgtaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2726 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKRNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2727 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggtatagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2728 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWYSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2729 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaactgaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2730 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKLTNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2731 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctgaccaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2732 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLTKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2733 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttattatattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2734 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYYITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2735 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttcgtggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2736 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFRGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2737 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggtaaaaccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2738 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGKTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2739 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccattaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2740 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTIKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2741 - DNA, 3684 bp, Artificial Sequence
  Synthetic
atgagcaaactggaaaagttcaccaactgttatagcctgagcaaaaccctgcgttttaaagcaattccgatgggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2742 - protein, 1228 aa, Artificial Sequence
  Synthetic
MSKLEKFTNCYSLSKTLRFKAIPMGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2743 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtgtgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2744 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGVNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2745 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcaacagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2746 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESNSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2747 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttaaagacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2748 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFKDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2749 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagattgtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2750 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQIVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2751 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatctggtacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2752 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKIWYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2753 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaatttctccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2754 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKISPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2755 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgccgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2756 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALPSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2757 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagctttaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2758 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSFKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2759 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgacgatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2760 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDDHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2761 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaacgtcaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2762 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVERQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2763 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtggcctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2764 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICGLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2765 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatcgttttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2766 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNRFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2767 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatctatgacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2768 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIYDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2769 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcaggattggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2770 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQDWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2771 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgaagccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2772 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTEADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2773 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaagtatgacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2774 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKYDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2775 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattccatctggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2776 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFHLDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2777 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttaacctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2778 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFNLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2779 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgctggatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2780 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLLDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2781 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcagcgcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2782 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEAAQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2783 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccaccaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2784 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTTKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2785 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgcagtatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2786 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAQYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2787 - DNA, 3684 bp, Artificial Sequence
  Synthetic
atgagcaaactggaaaagttcaccaactgttatagcctgagcaaaaccctgcgttttaaagcagcgccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2788 - protein, 1228 aa, Artificial Sequence
  Synthetic
MSKLEKFTNCYSLSKTLRFKAAPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2789 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggcctctatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2790 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLASMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2791 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcgaaggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2792 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSEGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2793 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccagggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2794 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNQGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2795 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagctggacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2796 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKLDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2797 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaaaaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2798 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKKIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2799 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgtctggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2800 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVSGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2801 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggttgctatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2802 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGCYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2803 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaacgtgaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2804 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNVTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2805 - DNA, 3684 bp, Artificial Sequence
  Synthetic
atgagcaaactggaaaagttcaccaactgttatagcattagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2806 - protein, 1228 aa, Artificial Sequence
  Synthetic
MSKLEKFTNCYSISKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2807 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgtttgtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2808 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVFVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2809 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccgccgaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2810 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPPNSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2811 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctggaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2812 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLETKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2813 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgtatgtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2814 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLYVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2815 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggtgatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2816 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGDISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2817 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatggcaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2818 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADGNGAYNIARKVLWAIGQFKKAEDEKLDKVKIAISNKEWLEYAQTSVKH

SEQ ID NO: 2819 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctatatgaacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2820 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYMNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2821 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagcttttctggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2822 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFSGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2823 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctgcaggaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2824 - protein, 1228 aa, Artificial Sequence
  Synthetic
MSKLEKFTNCYSLSKTLRFKAIPVGKTQENIDNKRLLQEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2825 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagattgtgaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2826 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIVNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2827 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgatgacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2828 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMMTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2829 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgtgctggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2830 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFVLDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2831 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtatgctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2832 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICMLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2833 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttaacaatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2834 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFNNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2835 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgccgacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2836 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLPTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2837 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaacagatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2838 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKQMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2839 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgtgtggaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2840 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERVEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2841 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgtgggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2842 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGVGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2843 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtctgcgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2844 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGLRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2845 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaacttttttgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2846 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFFETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2847 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatatggttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2848 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDMVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2849 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagctttatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2850 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSFIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2851 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggtgtgcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2852 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGVQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2853 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctggggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2854 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFWGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2855 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaactggatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2856 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKLDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2857 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcaacattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2858 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEINIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2859 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactggtgaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2860 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLVNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2861 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaaatgatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2862 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKMIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2863 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatgtgcatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2864 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMCIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2865 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgactgctataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2866 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDCYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2867 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcctgtatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2868 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRLYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2869 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattaccaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2870 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDITKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2871 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaagatgttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2872 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKDVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2873 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaattggattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2874 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNWITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2875 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgatgttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2876 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPMFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2877 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaaccaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2878 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKTNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2879 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaaaaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2880 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKKNKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2881 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaccgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2882 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNTVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2883 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcacctggaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2884 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTWKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2885 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccgtgcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2886 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETVRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2887 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgaagagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2888 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFEEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2889 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagccagaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2890 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSQKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2891 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagaaagaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2892 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKEKENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2893 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaataaaatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2894 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENKIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2895 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttactataaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2896 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYYKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2897 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggcggcatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2898 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGGIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2899 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaacgtctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2900 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKRLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2901 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttcgtggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2902 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFRGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2903 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagccgtagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2904 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESRSKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2905 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaacattgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2906 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEHCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2907 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgcggataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2908 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHADNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2909 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgccggtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2910 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPPVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2911 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgcgtctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2912 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPRLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2913 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatcagtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2914 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDQYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2915 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcgatctgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2916 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGDLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2917 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaagatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2918 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKDTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2919 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactggaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2920 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLEEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2921 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctggtgacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2922 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLVTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2923 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaatattttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2924 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEYFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2925 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcatttgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2926 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYAFADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2927 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccgtgcagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2928 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTVQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2929 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattgcatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2930 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENCIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2931 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaatatgcatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2932 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENMHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2933 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggttttctgcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2934 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFLREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2935 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggtttgcaaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2936 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVCKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2937 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgatattgaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2938 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDIEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2939 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccgcggcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2940 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAAAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2941 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcaacgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2942 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAINDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2943 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatcgtaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2944 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINRNLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2945 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaataactgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2946 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNNCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2947 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaagaaaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2948 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEENVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2949 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatcattttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2950 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDHFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2951 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattctctccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2952 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFSPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2953 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatgatattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2954 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDDIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2955 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattatgaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2956 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIMKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2957 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacactatgtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2958 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHYVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2959 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatgtggatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2960 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNVDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2961 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttctgggaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2962 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFWENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2963 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtctgagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2964 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRLSLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2965 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctgcaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2966 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNICKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2967 - DNA, 3684 bp, Artificial Sequence
  Synthetic
atgagcaaactggaaaagttcaccaactgttatagcctgattaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2968 - protein, 1228 aa, Artificial Sequence
  Synthetic
MSKLEKFTNCYSLIKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2969 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaacaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2970 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPNNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2971 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcatggcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2972 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSMAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2973 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgctgttcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2974 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPLFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2975 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggtgatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2976 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGDQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2977 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcagaaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2978 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVQKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2979 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaccgttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2980 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDEPFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2981 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtccgctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2982 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICPLVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2983 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctgattaaagtgaaaattgcgatcagcaataaagagtggctggaatacgcacagaccagcgttaaacat

SEQ ID NO: 2984 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLIKVKIAISNKEWLEYAQTSVKH

SEQ ID NO: 2985 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattaactatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2986 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRINYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2987 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgattttgtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatatttgcaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2988 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDICKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2989 - DNA, 3684 bp, Artificial Sequence
  Synthetic
atgagcaaactggaaaagttcaccaactgttatagcctgagcaaaaccctgcgttttaaagcaattccggttggtaaaacccaagagaacattgataataaacgcctgctggtcgaagatgaaaaacgcgctgaagattataaaggcgtgaaaaaactgctggatcgctattatctgagcttcattaacgatgtgctgcacagcattaaactgaagaacctgaacaactatatcagcctgtttcgtaaaaaaacccgcaccgaaaaagaaaacaaagagctggaaaacctggaaatcaatctgcgtaaagaaatcgccaaagcgtttaaaggtaacgagggttataaaagcctgttcaagaaagacatcatcgaaaccattctgccggaatttctggatgataaagatgaaattgccctggtgaatagctttaatggctttaccaccgcatttaccggcttttttgataatcgcgaaaacatgttcagcgaagaagcaaaaagcaccagcattgcatttcgctgcattaatgaaaatctgacccgctacattagcaacatggatatctttgaaaaagtggacgcgatcttcgataaacacgaagtgcaagagatcaaagagaaaatcctgaacagcgattatgacgtcgaagatttttttgaaggcgagttctttaacttcgttctgacccaagaaggtatcgacgtttataacgcaattattggtggttttgttaccgaaagcggtgagaaaatcaaaggcctgaatgaatatatcaacctgtataaccagaaaaccaaacagaaactgccgaaattcaaaccgctgtataaacaggttctgagcgatcgtgaaagcctgagcttttatggtgaaggttataccagtgatgaagaggttctggaagtttttcgtaacaccctgaataaaaacagcgagatctttagcagcatcaaaaagcttgagaaactgttcaaaaactttgatgagtatagcagcgcaggcatctttgttaaaaatggtccggcaattagcaccatcagcaaagatatttttggcgaatggaatgtgatccgcgataaatggaatgccgaatatgatgatatccacctgaaaaaaaaggccgtggtgaccgagaaatatgaagatgatcgtcgtaaaagcttcaagaaaattggtagctttagcctggaacagctgcaagaatatgcagatgcagatctgagcgttgtggaaaaactgaaagaaatcatcattcagaaggtggacgagatctataaagtttatggtagcagcgaaaaactgttcgatgcagattttgttctggaaaaaagcctgaaaaagaatgatgccgttgtggccattatgaaagatctgctggatagcgttaagagcttcgagaattacatcaaagccttttttggtgagggcaaagaaaccaatcgtgatgaaagtttctatggcgatgcggtgctggcctatgatattctgctgaaagtggaccatatttatgatgccattcgcaattatgttacccagaaaccgtatagcaaagacaagttcaaactgtactttcagaacccgcagtttatgggtggttgggataaagataaagaaaccgattatcgtgccaccatcctgcgttatggtagtaaatactatctggccatcatggacaaaaaatacgcaaaatgcctgcagaaaatcgacaaagatgatgtgaatggcaactatgaaaaaatcaactacaaactgctgcctggtccgaataaaatgctgccgaaagtgttctttagcaagaaatggatggcctattataacccgagcgaggatattcaaaagatctacaaaaatggcacctttaaaaagggcgacatgttcaatctgaacgattgccacaaactgatcgatttcttcaaagattcaatttcgcgttatccgaaatggtccaatgcctatgattttaactttagcgaaaccgaaaaatacaaagacattgccggtttttatcgcgaagtggaagaacagggctataaagtgagctttgaaagcgcaagcaaaaaagaggttgataagctggttgaagagggcaaactgtatatgttccagatttacaacaaagattttagcgacaaaagccatggcaccccgaatctgcataccatgtactttaaactgctgttcgacgaaaataaccatggtcagattcgtctgagcggtggtgccgaactgtttatgcgtcgtgcaagtctgaaaaaagaagaactggttgttcatccggcaaatagcccgattgcaaacaaaaatccggacaatccgaaaaaaaccacgacactgagctatgatgtgtataaagacaaacgttttagcgaggatcagtatgaactgcatatcccgattgccatcaataaatgcccgaaaaacatctttaagatcaacaccgaagttcgcgtgctgctgaaacatgatgataatccgtatgtgattggcattgatcgtggtgaacgtaacctgctgtatattgttgttgttgatggtaaaggcaacatcgtggaacagtatagtctgaacgaaattatcaacaactttaacggcatccgcatcaaaaccgactatcatagcctgctggacaagaaagaaaaagaacgttttgaagcacgtcagaactggaccagtattgaaaacatcaaagaactgaaagccggttatattagccaggtggttcataaaatctgtgagctggtagaaaaatacgatgcagttattgcactggaagatctgaatagcggtttcaaaaatagccgtgtgaaagtcgaaaaacaggtgtatcagaaattcgagaaaatgctgatcgacaaactgaactacatggtcgacaaaaaaagcaatccgtgtgcaaccggtggtgcactgaaaggttatcagattaccaacaaatttgaaagctttaaaagcatgagcacccagaacggctttatcttctatattccggcatggctgaccagcaaaattgatccgagcaccggttttgtgaacctgctgaaaacaaaatatacctccattgccgacagcaagaagtttattagcagctttgatcgcattatgtatgttccggaagaggacctgtttgaattcgcactggattacaaaaatttcagccgtaccgatgccgactacatcaaaaaatggaaactgtacagctatggtaaccgcattcgcatttttcgcaacccgaagaaaaacaatgtgttcgattgggaagaagtttgtctgaccagcgcatataaagaacttttcaacaaatacggcatcaactatcagcagggtgatattcgtgcactgctgtgtgaacagagcgataaagcgttttatagcagttttatggcactgatgagcctgatgctgcagatgcgtaatagcattaccggtcgcaccgatgtggattttctgattagtccggtgaaaaattccgatggcatcttttatgatagccgcaattacgaagcacaagaaaatgcaattctgccgaaaaacgcagatgcaaatggtgcatataacattgcacgtaaagttctgtgggcaattggccagtttaagaaagcagaagatgagaagctggacaaagtgaaaattgcgatcagcaataaagagtggctggaatacgcacagaccagcgttaaacat

SEQ ID NO: 2990 - protein, 1228 aa, Artificial Sequence
  Synthetic
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDAVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH
